United States Patent 9,518,277 (GENETICALLY ENGINEERED MICROBIAL STRAINS INCLUDING CHLORELLA PROTOTHECOIDES LIPID PATHWAY GENES) - sequence listing, part 16

SEQ ID NO: 49197 - DNA, 4705 bp, Auxenochlorella protothecoides
  modified_base (242)..(251): a, c, t, g, unknown or other
  modified_base (1367)..(1376): a, c, t, g, unknown or other
  modified_base (2004)..(2013): a, c, t, g, unknown or other
  modified_base (2960)..(2969): a, c, t, g, unknown or other
  modified_base (4470)..(4479): a, c, t, g, unknown or other
ttcggaaacgacgtggacaccttctacgactgcttgctggagggaaagagcggcgtggacaccattaccaggtgcagggctgcgctgagttgtgcgtcagggctggggtggttgagggatgggactggtatgggcgatggcaggctgttggtgacaatcatggtcccactcctccctcaagcgcctcctctgcatcacccaggtttgacatcaccgagttccccaccaagtttgccggccannnnnnnnnncctgccctgagttgggcgtcagggctggggtggttgagggatgggactggtatgggcgatggcaggctgttggtgacaatcatgatcccactcctccctcaagcgcctcctctgcatcacccaggtttgacatcaccgagttccccaccaagtttgccggccagatcaagtcctttgacgtggagggcctggtggacaagaagaatgctcggcggtacgacgacgccctttcctatgccatggtcgcatctaagaaggtgggttgattgtgtgtgaggcaggagaaccgaatcgggaccccgccatggcatgccagggcgtaggtattcaacaccccccctccttccgcactgaatgcatgacctccagtcactcccttgctttctcacctccactcttttccctgccgctgcacaggccttgcgtcaggcgggtctggagaaggaggcctgccccgaggggtacgagaagctggacaagacgcgtgtaggcgtgctggtaggctccggcatgggcggcctgaccgtcttccaggacggcgtcaaggccctggtggagaaggggcacaagaagatcacgcccttcttcatcccctacgccatcaccaacatgggtgggaggaggaagcggggccgacctgggtgggggaaagtttgcttgggtcagcgtgggcgtgtggcgctcgttctttctctgatcctgggcgcgtcgctggaacatgtctccccatcgcttcagagccccccggacccccgccccctctccctcaaacaggcagcgcgctggtgggcatcgaccagggcttcatgggccccaactactccatctccaccgcctgcgccacggccaactatgcatttgtgaacgcggccaaccacatccgcaacggcgacgcggacgtgatggtggcaggcggctccgaggcctccatcgtgcccgtgggcctgggcggctttgtggcctgccgcgcgctgtctacgcgcaactttgagccctggcgcgccagccgaccgtgggacgcgggtcgcgacggctttgtcatgggcgagggcgcgggcgtgctggtgctggagtccctggagcacgcccaggcacgcggcgccaccatcctggccnnnnnnnnnnctgcttgggtcagcgtggccgtgtggcgctcgtcctttctctgatcctgggcgcgtcgctggagcatgtctccccatcgcttcagagcccctcgggcccccgccctttcttcctcaaacaggcagcgcgctggtgggcatcgaccagggcttcatgggccccaactactccatctccaccgcctgcgccacggcaaactatgcattcgtgaacgcggccaaccacatccgcaacggcgacgcggacgtgatggtggcgggcggctccgaggcctccatcgtgcccgtgggcctgggcggctttgtggcctgccgcgcgctgtccacgcgcaactttgagccctggcgcgccagccgaccgtgggacgcggggcgcgacggcttcgtcatgggcgagggcgcgggcgtgctggtgctggagtccctggagcacgcccaggcacgcggcgccaccatcctggccgagtacctgggcggcgccttcacctgcgacgcgcaccacatgaccgacccccaccccgagggcctgggcgtgagcacctgcatccggctggccctggccgacgcgggcgtggaccgggacgaggtcaactacatcaacgcgcacgccacctccacgctggtgggcnnnnnnnnnntgagggcctgggcgtgagcacctgcatccgcctggccctggccgacgcgggcgtggaccgggacgaggtcaactacatcaacgcgcacgccacctccacgctggtgggcgacaaggcggagatcaaggccgtgcgcggcgtgtttggcgacatgcgtggcaccaagatgaacgccaccaagtccatgatcgggcattgcctgggcgcggcgggcgggctggaggccatcgccaccatccaggccatccgcacggggtgggtgcaccccaccatcaaccacgacgaccccatcccggaggtggagggcatcgacatcgtgcccaatgtcaaggcgcggcatgacgtccgcgtcggcatctccaactcctttggcttcggcgggcacaactccgccgtcgccttcgggccctacaaggaggcatgagccggcggccgagtgggtgggagtgcggggctggcgcggcgcgagggatggcaggccctgctcttccgcgcacatcgacgaccccccggcgcccgacttggctgccgatcagcgacccgggcgccagcccgagagaatgagctttgctgcagggcgctcgaccgtgccaaccgcagcgcccctcagggacccaggcatgcccccccttccccaatccctataatcgtcttgtgtgaatccacctcttgactggcaaggactgtacacagcacaaaggagagtcttcacaccgtatcatgtgggaatgcctggataacttatcagcctgtcatgcttgcggtcgcggcagggacgtcgcaacctctgttatgcatgggcagcgaaggtctgctcagacccagagaagctgcgactccaggcctgacgccgaacaggaggaatggtggatcccaggcaggcgccaacccaggacggtctacccctccccgccctcagaactgctcgctgcggctggccacggcgnnnnnnnnnngcggcggccgagtgggtgggagtgtggggctggcgcggcgcgagggagggcaggccctgctcttccacgcatatcgacgaccccccggcgcccgacttggctgccgatcagcgacccgggcgccagcccgagagaatgagctttgctgcagggcgctcaatcgtgccaaccgcagcgcccctcagggacccaggcatgcccccccttccccaatccctaaaatcgtcttgtgtgaatccatctcttgactggcaaggactgtacacagcacaaaggagagtcttcacaccatatcatgtgggaatgcctggataacttatcagcctgtcatgcttgcagttgcggcagggaagtcgcaacctctgtcatgcatgggcagcgaaggtctgctcagacccagagaagctgcgactccaggcctgacgccgaacaggaggaatggcggatcccaggcaggcgccaacccaggacggtctacccctccccgccctcagaactgctcgctgcggctggccacggcggcgctcacccggcccagcacctcctgccaggtcagcgcgcccaccggcccgtcgcggtaggtgcgcaccgacagcgtcccggcctccgcctccgccggtcccaccacgcacatgacggggaccttggccttctccgcgttgcgcaccagctttcccatgctcatgcctgccgtgggtgtggggaggggtgtgttgaggctggtttcggtaccagagggggacacattatctcgcgccggcacacctggggcagcctccgcccccatgaacgcagccgaccaccctgcagaacccccctcccacccccaggcctcgcacctcccgcgacctccacgcgaatgttgtgtgcccgcatggcggacgccacctcctccatgtacggcctcactgcgtcgctggtgggcagcagcctgacctgctcaggcgccagccagagcgggaaggcgcctaacaggaagaggggggggggacggacaaagcattgcacagcaatgagagggatgcgaggatcgtgggcatggctgcctttgatcaataacagggattgagttccaaccccaggctgccggcccagctgcaacaacacagcatgatcaaccaactgatcaccccccccctccctcgccaataacacccacccacccatacctgcgtggtgctcgatcaggatgcccatgaagcgctccaggctgccgagcagcgcgcggtggatcatgatgggccgctccttctcgttccctgcggtggtgtaggccagcccgaaccgctccggcaggttgaagtccagctgcaccgtggagcactgccagcgccggccgatggcgtcctggatcttgatgtcgatcttggggccatagaaggcgccgcccccctcgtccacactgaacggccagccctgcgcgtggagggggagggagcgcgttacgcatgtgtatttggtgtgtcacaagaagggtagaaagggatgtgcaccatgcaannnnnnnnnntcagcccgaaccgctccggcagattgaagtccagctgcaccgttgagcactgccagcgccggccgatggcgtcctggatcttgatgtcgatcttggggccgtagaaggcgccgcccccctcgtccacactgaacggccagccctgcgtgtggagggggagggagcgcgttacgcatgtgtatttggtgtgtcacaagaagggtagaaagggatgtgcaccatgcaa

SEQ ID NO: 49198 - DNA, 5172 bp, Auxenochlorella protothecoides
  modified_base (365)..(486): a, c, t, g, unknown or other
  modified_base (1091)..(1100): a, c, t, g, unknown or other
  modified_base (1301)..(1310): a, c, t, g, unknown or other
  modified_base (2444)..(2453): a, c, t, g, unknown or other
  modified_base (2829)..(3022): a, c, t, g, unknown or other
  modified_base (3568)..(3577): a, c, t, g, unknown or other
atgtggcagagaatcctcagagcgaggaagactccccgcacgacgacctggccgcgcccatctgcgctgcgctggacgccctggaaagcgaggcgcgcgcgcgcttgcgcgccctcttccgcctgctgggcctccgggcggcggagccgggggcgcacgtggacacgctgcgcacgctgctgagcggcctggactttaactgttattacgagcgccagctggcgcacgcctgatgaggccagcagatggaagtctgaagctctgtgacactctactcagtttccatcctgatgcttcctgaccctttcccacccctcatctctcaatcatctgtccatgcacgtcgacttctcttactgcattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagcattgcagtgtatggaaagagtatggtggggggttgggcgtgtgccgccacggccgagaagggacctcaggccgtgagtgtatagagccaaaggggcatagtgatacaacttggatggaatgtgatttggggatggaaacgctccaggcaatggtgggggtaggggggcacgagccagcgggcaggccgccgcagttggcgccctcgcggaacggccatgcccgtcaggggtgcatggcagccccgcccccttccgactccttgcccttggcaaaaggtgggtgtggtgccccactgcttgaagagtcagcgtatccagggccgaccagcagagcctactcctcgcgtgacgcgaatatttccaaggcctccgctcagaccatgacctcgcggcctgagagccaggagaaggccactggcttgggcttggtcttggcgcgcttcgctgccgacttctcggccagcttgcggaagcgggagggcaggcgcagcacgtactcctggtcggcgccggcgtcgccggacacggtgcggtccgcaatcttccacctggaattcaggtgctccaggatcttgcagtagtcctcagcatcatacactnnnnnnnnnngactgagccacatattagatggcgatcctgagggtagctcgtcgcaccccatgttcaccacaccaaagctggcagcatcgcgacaaactgcggccgccctcctagagatcccctccctggatccgcacctacaagcaaactcaccatccagcttctcggtgactgccgagaagtcggcaaacaggttgcgccccgtgttgnnnnnnnnnnaactgagccacatattagatggcgatcctgagggtagttcatcgcaccccatgttcaccacaccaaagctggcagcatcgcgacaaactgcagccgccctcctagagatcccctccctagaaccgcacctacaagcaaactcaccatccagcttctcggtgactgccgagaagtcggcaaacaggttgcgccccgtgttgcgcgtcccgtgctgctggtcgtccatgaggtgcgcgggcatggtgatctgcttgcgcatcatgtcggcgtaggcagacatggcgccctccgggtccaggcggaagaactcctccacgatgcgggtgtaggcgatctcgtgccgcccctcgtccgcggcaatcacgccgcagaccttggaaagcgtggcgtcgccatactgcgcggccaggcgcgcggtgttgccgtggctgtacttggtggcgcgctcctgcgatgcgagcaagggggtggggcttgtgaaatggtcgacagggggtgaggggcctgggtggggggttggaggctccagtctgcacgcatgcagactcaaaggtgacgccaaccaccagcacaaatgaggaccacctccccgccacacagaccggctcctcaacccccaaacacacccagcaccctgtacctggaaggaggtgtagacaaagcccagatacgggttgttctctgtcttggggttcatccccgagccgatcaggttctggatggtcacctcgatggccttcatgttgacgcgtcccgtcagccagcagtacttgttgagcaggtcgccgtggcggttctcttcggccacccactgccgcgtccagcggccccaggggtggtccgccgcccccgtctcatcgcgcacgccgtccagggtgttcagcatggccatgtaggtgggcagcgcctcctcggtgatcatgtcgcccaccagcaccacaaagtagtcgtcggggacgttggcggcgcgggcccgcagctctgccacctgatccaggaagtcgggggactcggggtccgggagcaggtcctggggctgccacagcttctccacaggctgcaggacgggcaggatccgctcctcagcaaaggccgacatgccgttgatcagctccatgcgctccggggtcaggnnnnnnnnnngagggggtgaggggcctgagtgggaggttggaggctccggtatgcacgcatgcaaactcaaaggtgatgacaaccaccagaacaaacgaggaccacctccccgccacacaaaccggctcctcaacccccaaacacaccccagcaccctgtacctggaaggaggtgtagacaaagcccagatacgggttgttctctgtcttggggttcatccccgacccgatcagattctggatggtcacctcgatggccttcatgttgacgcgtcccgtcagccagcagtacttgttgagcaggtcaccgtggcggttctcttcggccacccactgccgcgtccagcggccccaggggtggtccgccgcccccgtctcatcgcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtccaggaagtcgggggactcggggtccgggagcaggtcctggggctgccacagcttctccacgggctgcaggacgggcaggatccgctcctcagcaaaggccgacatgccgttgatcagctccatgcgctccggggtcagggtgtgggccttgtccagcttgctgtaaactgtgggcccgggccggggggaggtggtggccacggggacctcgctggcgatggcagcgcgcacggggaggggcctcgctgggcgccggggcccggagcccgctgagcgacgcaggtcgccgcagcgggcatcgaacgccgagaaagtggatgcggtggccatgtggtcggctctccacaggaacgcggtgccctgcgcagcaaggggagggaggtgggcagcgcgtgacgcctggtggggaggccatgattcccggccagcggacatgcgatgacaggatgcccgaagtctgcctatttcgcggtcgcgtggtgcaatgtgggcacctccctggcatgtgagctcctccgacacccaacgcaggtgtctcgggannnnnnnnnnagccagcggacatgcgatgacaggatgcccgaagtgtgcctgtttcgcggtcgcgtggtgcaatgtgggcacctccctggcatgtgagctcctccgacacccaacgcaggtgtctcgggaggggtgctccatgcggacacgcacctgctggggagctgaacgatcgatgtcacgagctgttgagcagagcctgatgcagtaactcccttgcagataagtgtgtgttttgtgggcgatgcaacgccttgagtatatcacccgtcctcgccaggcaatctggcaatgacaatttctgatcgactccaggccgaggtcgatgcagggtaagaaatccggaatccaagttgcgagagcgcgccctcagactcgtctcggaccgcggtctccttcctgctggccactcaacgctgtaatgtacgcagacgaatcaaaaagctgacatcaaagtgcagaggataaaactgcgtgagaattgttaggtggtagccagtttttggggcactgcaagcctttgcgatcaaccgcaccatgtccgacacccccggcacatctgccggaacgggagcagaggactacgagcatcccatctcccatgaagacgtatgactctgattgcatatggaatccacacgcatgcagcgcactatcgcctggagagaggggtactgtttgatgacgtcatggttccacctccactcttatctttctccaccatacagttccggcagctaggctacaagatgatagatgccattgtagactatagatcaaatattgaaaagcaccctgttcgttcagaagtcgcccctgggtacctggccgagaagctcccagaatctgcccccacccagccggaagggctggatgccatcttgtcagacgtacagacgcacatcatgcctggtatcacccactggcagcaccccagcttcttctcgtgagtcgtgggaacctggagggcgggttgttcagtgatatggggagttgcaaatagctaaggcttgactacggcggaagcatcccgcttactggcaaactgtctattcacattgcctgccatgagagccttcatattcacacaatcaatctgtggcatttcttacaccctctgaatctgcaacctgtagatggtatccagcgaattcttcgtaccctgccctcctgggtgacatgctgagctcggcccttggagtcgtagggtttgcctggataggctcccccgccgcgacagagcttgaaacggtgggtttccttggtgttttgaaaccatttttgggagctgggaggagttttgtaggacattcagaccgtgctcctggcagcaagcacggtcatgaggcagcgtgactgcatccacctggcaattcaagcttccattgcgggtcctagcttccgaaacagaaaggctgtgcatggaatttctccctcggatgccctccaatcccctgcatcacttcctgctgcaggtgacgctggactggttggcccggttcctgcgcctcccaaatgccttcctatccaccggcaccacgggcggcggcggcgtgatccagggcaccgcctccgaggcggccctggtggcgctgctggccgcg

SEQ ID NO: 49199 - DNA, 4867 bp, Auxenochlorella protothecoides
  modified_base (376)..(385): a, c, t, g, unknown or other
  modified_base (1245)..(1254): a, c, t, g, unknown or other
  modified_base (1833)..(1842): a, c, t, g, unknown or other
  modified_base (2456)..(2465): a, c, t, g, unknown or other
  modified_base (2860)..(2869): a, c, t, g, unknown or other
  modified_base (3761)..(3770): a, c, t, g, unknown or other
  modified_base (4114)..(4123): a, c, t, g, unknown or other
  modified_base (4326)..(4335): a, c, t, g, unknown or other
caggaagcgctgacgcacaacggcgcaggcagggagccggcctgctacgtgcacagcctcctgcgcggcgagacggagctggtccgcgcgcggaccacgtggcgagtgtccgacgcgacccgtggtggtgtcgccgcccacggcagcgctgcggcggcctccaacggcagcgctgcggcggcttccaacggcagcgcccctcatgccaacggaaacggcgcccactgatgctcccagtgggatggacgtgagagtgtcgggagggacgcagcatttgcgacgttggacccccccggcctggtcatgggggatgcaggcagtggtggatgccagggcggcgccgtggcgggcaggtcccgcctgcagcgaccctcgnnnnnnnnnnccaggtcgcgcgccgcgccgacatggacatgaatgggcacgtgaacaacgtggcctacctggcctggacactggaggcggtgccggaagaggtctgggccggttctcacctgtaccaggtggagatcgacttcaaggccgagtgccacgcgggagacgtggtctgctccctggcgcagcaggtgccgccgcaggaagcgctgacgcacaacggcgcaggcagggagccggcctgctacgtgcacagcctcctgcgcggcgagacggagttggtccgcgcgcggaccacgtggcgagtgtccgacgcggcccgtggtggtgtcgccgcccacggcagcgctgcggcggcctccaacggcagcgctgcggcgacctccaacggcagcgcccctcatgccaacggaaacggcgcccactgatgctccccgtgggatggacgtgagagtgtcgggaggggcgcagcatttgcgacgttggaccccccccgggctggtcatgggggatgcaggcagtggtggatgccagggcggcgccgtggcgggcaggtcccgcctgcagcgaccctcggcggggcccgcctgatgtgacgggccgggctgcgccagccttcagctcacgctgtgcgccctgctttttggaggtgcagacgcatgcacacatgccctgtcgccccctggcctcctcgggttctccagcccaggacagtgggcggggcccatctccccttccctgtacttatacgaccgagtctaggtgtgcttggggggctcctgagactggagcagttcccctcctcagcgcaccccgactcttgcgatcaccttgctgctctgcactcctaagttcgtcatttcatgagtnnnnnnnnnnctctcaagcccaggacagtgggcgggcccatctccccttccctgtacttatacggccgagtctaggtgtgcttagggggctcctgagactggaacagttcccctcctcagcgcaccccgactcttgcgatcaccttgctgctctgcactcctaagttcgtcatttcatgagtgaaaaattgtcgtgctggtgagagagggagaagccgccgtcgctctgtgaggcggccggcagttcccgtggctcaccaacgaccgcgcagaacttgcctacagtagttttcgtgctgtaagtcaactaatataagcttgtaacattgaatggcacagcgatacggaaggatgaggcacagcggtggtaggtatgattgccgttcgccgttctcctgaaatgggaactccaacatggagcagccatcgcggtcacacgactttcctcgcactctggcccaaccaagacctctgtggtcacttgggctggttgaccttcaagagaagaagcaacacaacagaacgcacaccacaaccatccagcctgggccttggtgccacctgcagggcgcttacacatgcagctgcnnnnnnnnnnggagggagaagccgtcgtcgctctgtgaggcggccggcagttcccgtggctcaccaacgaccgcgcagaacttgcctacagtagttttcgtgctgtaagtcaactaatataagcttgtaacattgaatggcacagcgatacgaaaggatgaggcacagcggtggtaggtatgattgccattcaccgttctcctgaaatgggaactccaacatggagcagccatcgcggtcgcacgactttcctcgcactctgccccaaccaagacctctgtggtcacttgggctggttgaccttcaagagaagaaccaacacaacagaacgcacaccacaaccatccagcctgggccttggtgccacctgcagggcgcttacacatgcagctgcagacatggcaagaaagggtctgtgggtggcactgcacctgcgccggcatccgtcctcgacgacttcagtgtgagggaggaaggtccggcgcatggcaggagaaggatttagctcgtgcagcaacaagggagttccaacaggggcggcccatactggcatgggtatggtgcattgcagcgggcctgaacgctcaaggggtgaccaagcgacaggggctggccgctgtaccnnnnnnnnnnaaaggggtctgtgggtggcactgcacctgcgctggcatccgtcctcgacgacttcggtgcgaggaaggaaggtccggcgcacggcaggagaaggatttagctcgtgcagcaacaagggagttccaacaggggcggcccagactggcatgggtatggtgcattgcagcgggcctgaacgctcaaggggtgaccaagcgacaggggctggccgctgtacctacggagcaatgacacagccccaggcgcaggtgtggttcacctcggcgatacggtggtcccagcacactgcgctcagaaggcctccacctcccgcgcaaagcacttgtcccaggcggcccgcaggacggggacgagcatgatcgccgccagctggggcacgtcgtgcgagttgatgnnnnnnnnnncgtggttcacctcggcgatacggtggtcccagcacactgcgctcagaaggcctccacctcccgcgcgaagcacttgtcccaggcggcccgcaggacggggacgagcatgatcgccgccagctggggcacgtcgtgcgagttgatgcgcagagccagggtaccttggccccgggtggtgtactgcgcattggcggagacctgggtgtcggacttcatccccgtcccgtccatcttgggcagccgcacctcgcccgcgatgttcccgcccatgaccagagactgcttggcggcgcgcttgtcgcggccctgccactgggcggagccgcccaggagcagctgtgtgatgtgttgggtgagtcccagtgagtcactgatgcaagaaggggcttagacacctgaacaaaaactgtggtcgttccgagcatggatgaccttcctctacgaaaggagggaggcgccagccacattccttgttgtgtgatgcgcatgaggcaaggacgagtccctttcccccctcttctctggcccccttcccctccctccacacacccgtgcgctgtcgtcggccgggttgcgcagcttcaggtcggccgccaccgccgtgccgggctcgtagtgggtgcccatcttggtgagcagcctgcccacggcggcacgcagcttgatgctgtcagtgatgcgcagccgctcgtccagcttcagcccgtacgccccgttgcctccctgtcggggtgcgtggtgggttgagggagtgggggatgagagtcgcaaagccagaagatcagcctgactccatgtagcctgcagtgttcaacattgcaccgactgactgggccccttctccacatggccgactcacttccggctgctccttgcaggcctgacaccaagnnnnnnnnnnggactgcttggcggcgcgcttgtcgcggccctgccactgggcggagccgcccaggagcagctgtgtgatgtgttgggtgcgtcccagtgagtcactgatgcaagaaggggcacagacacctgaacaaaaactgtggtcgttcccagcatgcatgactttcctccacgaagggagggaggcgccagccacattccttgctgtgtgatgcgcatgaggcaaggacgagtccctttccccctctcctctgcccccccttcccctccccccacacacccgtgcgctgtcgtcggccgggttgcgcagcttcaggtcggccgccaccgccgtgccgggctcgtagtggnnnnnnnnnnattgaccgaggcgtagctgacccagtaggtggagtggtacagcgcggcgtccgactcgcctgcagattgggaatgtgcaggatcagtgaggagttgattttggtgaacgtgaggtgtgtcagagaggagcaggagagaaaccgtttccctccatatcacacacacccaaactcccctccccccacctcccccaacacccccannnnnnnnnnacgtggtgggttgagggggggggggatgagagtcgcaaagccagaagagcagcctgactgcatgtagcctgcagtgttggacattgcaccgactgactgggccccttctccacatggccgactcacttccggctgctccttgcaggcctgacaccaagcctcttccccacttttcaagcaacacatacccctaccttgatgggcggcagggtgaagtcctcgcccagcttgctggccagcaggccgacggtgaacttctggcgcttgcccttgctgcgcacccggctctccaaccggccggtgtagagcacgtcgcgctggagcgactgcgcgttgaccgaggcgtagctgacccaggaggtggagtggtacagcgcggcgtccgactcgcctgcaggttgggaatgtgcaggatcagtgaggagttgattttggtgaacgtgaggtgtgtcagagaggagcaggagagggaccgtttccctccatatcacgcacacccaaactctcctgcccccacctcccccaacacccc

SEQ ID NO: 49200 - DNA, 11796 bp, Auxenochlorella protothecoides
  modified_base (2739)..(2877): a, c, t, g, unknown or other
  modified_base (11003)..(11129): a, c, t, g, unknown or other
gctggtcatctgcccgctggtggctgtcatccagtggcgggcggagatcgagcgccacgtggcaccgggcgcgctgcgcgtcgccacctaccacggcagcaagcgcaccgccgacccgcacgtgctggcaggggcggacgtggtgctcaccacctactccaccctggagaacgagttcaggtgggtgcctgagtgtttccaggaaaggggcgcggagggtgcagtgctccggggtttctgggcgctgctttgacgggtgcccgaggcagcatgggtggtgggatggaagtgcccagcccgggggaaggggtcctgccgggccgctggggcacgctgccgtgcgcgtgcctgcggcgctcatgctgggtgtgggtgcgtgcggtgtctctcacaatctctgagcaattgcagcgacgccgtcgccacccagggctgcattcaatccccccctcgcccactcattcccaaaggcgggcttttgcggccgagagggtgacgtgcgactactgctccaaaaagttcaccgtcgaccgcctgaagctgcatctcaagtacttttgcgggccgttcgcgaagaggaccgctgcccaggcgaagcaggaacggtcccgccccacaagtgcgcatgggtgtgaaggtggggagctgcccaaaagtacatgcaggccttgtagcgagggaagcagtgagggatcgcagcgaccctgtgaggccagagactggacactgagttccagcgcggtcgtgagcgctgcgaccatgctcgctgtccccggacccactctacccatcgtgccctttgtgcagggcctctgatgcccaaagggaaaacagggaggaaggacggcaaaacacaggctggggcaacggggaagcatgacgccgcacaggtgtggggagcctgtcttgatgaggaggtgggtggggtgcgatgcgcgcgcccatggtactaccccccctcccgtgtcttgcggccttgagcccccgtcaccagcgcctcgggaagcagtcttgcacccgtcctgaccatctctcttgaccattccaccctgcagaaaacaaaagctggcaagaggaagaagctgggggaggagccacaagccgatgcagaccctgacagcgatcacccgacgaacgtggcgcgggaggagctccgtgcactgctggcggctggtgcgagcggggggccgcatggcgcggtacgtgccggcccgggattcggcggcaggatcgagccagagtccgccgcggcggcggccgccgacgagatgatcgcgcgccaggccgccgccgtcctggatgaggaggacacagatgagccgagctcggtcatccaccaggtgtgctgggcggtggagcgaggaccagggcgggggcgtcagagcacatgcacttggttctctcctgcacagcagccatcctcccgtcagggtggggcgccgggtgcatgtgcaaaccctgagggtcctggatgggcggcgcatgcagctgggctgggacgcgacccaggctgccacctgcctccatgcccatcgccgcgaagagcctgccccgccacggtctttgcgacctccttcccactccctcgcgcccacaggtccactggcggcgcatcgtgctcgacgaagcccacagcatcaaggaccggcgctgctcgacggcacgcgccgtgtttgcgctgacctccaggtatcgatgggcgctctcgggaacacccctccaggtgaggcaagggagcagggggaggctggcatcagcaaaaaggcccaagtactggcggggggtaagcgtttggatccccagagggctgtttgagtgttgttacagagctgtgctgagcccccatgcctccccccaaccatccaccgtgcacgttcagaatcgcgtgggcgagctgtactccctggtgcgcttcctgcgcatctcgccctactcctactactactgccggtgcgtgaggttgcctgagagtgtggctggggatcggctgggtgcacaggaggtggagtctggggcagatgaatcctgtcaacctgcaatcatggcccatgatgcctgtctcgctcgaccgctgttcgcctcgcatccacggtgcttcgtccaccccccgcgtcgggtctcctacctcagcggtaccaaatttgaccccggctggggctgcggctcgcagcggatgcacctcatgcagccgctgcgagtcgcagccctccatctttaccgttaacacacacacacacacacaccctctccactgtgtgcacagtgcctgcgagtgcaagcacctggactaccccttcaagaacgcctcccgcacgtgccacagctgcaagcacggccccctgcaccacttctgctggtggaacaagtatgtggccaaccccatcaagcggcacggctaccagggtctagggcgcgacgccatgctcgtgctgaagacggaggtgaggcgtggtggatgaggggcagcagcacctgggaaggcggacggccaccgccgctgttcagattgttgggcccacgcggcacgggcaccctcactccccgggccccctctgagtacccctgcaaacttgtttgcccacccatgcatcatgagccgccgcaggtgctgccccgtatcctgctgcgcaggaccaagttccagcaggcggatgtcctggcgctgcctcctcggtgagttggcggtgtgtggcaaggccttcctctgctggctccaggcggtgcccagggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcttcaatccccactcacccacccatccaccggggcagcttggtcgtcctccgacgggacgccatggacgcggcggaggccgacttctatgaggccctgtacacgcagagccaggcacagtttgactcctacgtcgacatgggaacactcctgaatgtgaggcggcagggccgtcggcttggagaatgcacatgcagggttgggggcgaagttggtcctgggctgactggctgcggagggcctgcttgtatcgtggatccatcttggctggtggggagctgtgatgtgtggagggccagacatggtcctgcactccccgtgtgcgtgcagcagacccccgaacatgtctccattgccttgtcacatgacattgccctactccatggtcacgattctcacaccttttgcatccctttctctgcagaattatagccacatcttctctctgttggtcaggtgggggcatgcacgaggggaggatgtacaccgcaaggtcatgctggggcgtcacaagcaccccgccgctgcatcgacatgccgggcatgtctgtttgcagctgtctcccctgcagccaacccgccgctcatgccaaccatccctgggccccccattcacccctccaggctgcgacaggcggtcaaccatccctacctggtggttcacaactccacggatgcggcgggcgtggtggcaggcgggtttggggccggggccgacggcgtcgccgctgccgtggtggaggaggccacccatgaccacgctttggtccaggggctttgcagcatctgccacgacccgctggaggtagtgggcatgcgaaggagatgaatgcctggtgttgagtgcagggactgttgtggactgcttggcccaagacacaatgtacagctgttggtgacgcaagccgcagccaaacggatgcacagcagacgtggctgctacacaggcgattgtcctccaatctccctccaacattgtgctgtgcaggaaccggtggtcgccaggtgcgggcacgccttctgtagggcctgcgtgagcgagtttaccaactcggccgcggcgggtatgttggagaccggtgccctgtgtctccagagtgacatgtgttggctggcgcagggaaggactatgcccatcaaaggcgggtgctcctgtcgacggattcacagaacaggcctggcacatgcgcctcaccaattcccacgaccctgaccctgcgccattgtccccccaactgtcagacaccgtgacctgccccgcctgctccaagcccctctccctggacctggcctcgccagcggccacgccgggggtgcgaactagtcagtaccgcaaaaactccatcctctcccggtttgacaccgcccacttccagtccagcaccaagatcgaggcgctgagggaggagatccacaggtggaagggctgaagggggcgggggacggggcacaagtcgcctgcatcgccctcccttacaagactgacgctgacaggtctctgcccataaccacgcgcgctgtgcaggatgctggagcgggaccccagcgccaaggccattgtcttttcccagttcacatccttcctggacctctgctccttcaggtggagattaagtgttttggcacagggctcgagggatgccgtctttgtgctaagacacttgttgatgcgctgaaagctctatgatggcttgcattcccgtcgcctgatttttcagggtcccacccacttcctcagcaaactcctacccctgattgccaattccctcactcccacatgtttttcccttactttaaacctcccccaacttgcaggctccagcagtgcggagtgcggtgcgtgcagctgctgggctcgcagtccatggagcagcgcaacacccagattgaggccttctccaacgatccggacgtccgcgtgttcctcatgtccctcaaggccggcggcgtggctctcaacctcaccgccgcctcccactgcttcctcatggtgcgctggggggatggtgcctttgatttcctactggagggaatgcatgcatgcgctcctggcaggcctgcgccgacgacagtatcctcagggcatgggctgggtggagactggtacatttttggatcttctttgtgcaaatccttgggagttagccccagctcccatgtccttactcatgcttccaccaaaaccatggttcccacctctcccaataggacccctggtggaacccagccagcgaatggcaagcacttgacaggatccacaggctggggtgagaggttgcttcaggaagatggggtgtatgaacagggttggtcgtaattgtactttctgcgtcccgcgctgtcctgccttctttcatgatcggcatggcggccactgctaccttgcagcatccatctctttccacacctcaacatcctccactgcatccgcgctgcatcgccgccccgcaacaccccccaccacaggcagtacaagccgatgcgggcggtgcgcttcatcattgccggcagcgtggaggagcgcatcctgaagctgcaggacaagaagcagctcatcttcgagggcactgtgggccaggacaatgctgcgctggccaggctgaccgaggacgacctcaagtttctgtttggctgagggcggcgcctcggaaggaacgtgtgctgatgttggcagacgccctgctgccaaactcccaaccccccaggaacctagttgtgttccgaacgtgtatttacgctgtttattagttgtacaagagtcatcatctcgtcgtggcatgtgcctcgattcaaatgcatgtacagccccaggcttgttgagcactgtctgggctgcagagtgactgccaaatgcgcatgacagccccaggaaattccagggggtacagcagtgagaaagatgagatggcacgcattacacccgtgcagcccgggaatcgcattccgcttaagtgacacacatagcctcctccttggtccggaccccgacggaccagcaggcacctcagtgcgtcgcctgcagagtcttctgctctggggtctcggcctgcacctcgccagcctcctcgcgctgcctgcagtgggtggaaagggtggcgatggggtcatggtaaagtaggtcatatagtctggcagcgtctgcagctggccagtccagcctgacatgccccttgataatgctgggaggccatgcacggcatgggcccctccgaagctgctacacccgccaggcaatatgcggaccttttcccccacccgcgtcctccttccctctttctccgacgacaaaattcctccctcactcctcacctcctcaggctggccagcgcgcagtgggctgccttgagccccgagatgaacattgcgccaaaggtgggacccatgcgtgggcagccgtccagctcggccacttccatgccgcagatgaccatgccggggacgatctcgcgcgtgcggtccaccacggcgtcctcagcagtattcatgtccagcgcgcccatccccggcgctttctcgatcatgcccagcttggccagacgcttcacgcctgaccagggaatgagcagggactgatgagtccgggggatcaagggtgggtgggggtctccggagcttctgcctctgcagatgcaggatagagtctaggcgatgccctgcctccatgagcactctgcaccattatcaaagctccaggccctcccattatccgtctaagtatgaacagaagcaccgcacttcacctgaggcgcccatggggccgtcgtggccggtggaagaaaccatgaccttggacaggattgtgtttgggtccatgcacatctgggtgtcgtggttgagcgacaccagggtccagttggtcacggcacccgccacgtggcggccgccctttgcgggaatgtctttgacgatcaggtcctcggctgtgtgattggaggcgttgcgggagggtaggatcttgcgagggaacccagggtttgaggtgctgcaggcagtactgcaagctgcacccccatctacatgtcagaccctgggcaagggcaggccacctatgttccccgatgccccacccagtctcacccgcagtggcattgaagagcttgatgtttggggcggcgaggaccttggacaggagggtggaggtcatcagggcggcatgcttgaccaccacaaagttgccctgtcgttgcggcaggtagggggggtgtaatgtgaggaaggcggcgacccttgagtcgggggttgagtgagagtgcaaggccaggcacatgcaatacaagggaaccggcagagtgcatagtagtacaaggggccctggaaagcagggcgtacagcctcctacctcatcatcgtaggggatgctcagctcatccagcagcttgtgggctggcttgcggatctgttgcaatgaattagggatcttcaacataaagtacctacaatctgctggaatgcagccaccgagatagcactaaatacacacatcttgttttcccaacgagaatgtccaacacatggatatcaacaccctgcgcccaacccttgcttcagtccacccgtccccgtgcctagactcacacacatagccgagaagagctgaccccccagccacgctccacccccaggggcgacgccctgctcgatgatggccacctgttgcggggggttcaagcaggtgtaaacgatatccctgccccatgttgaaggctggggtatcatagcgtttccaacgcagcacacatgattgattgaggctgtgctgggaacaaccgcaagtttcaattgcaattacagcaacatcatctgaggatgtgccctgctcagcccataccttgacatccgggtgcttgctcagctcataggcgcacgagaggcccgcagacccagccccaacaatgacgacatcgacctgcggatgcgcggaagggatgtgccgatcattagctcaccggagaccttgcaagcatatcgcgcaccacacccatcataattagctgtaaatatatgcaaaagcacctcggcattgacgtttaggtcctcgaagtagcgggaggtcatggcgcggctgatctccgactccttgatgcccttgaacctggcaatccgggagtcgaaaaatgagtgctagtggcatgaggagggctgaagcagcacatgcgaatcctggatgcccacatctccgtacttgaagccatcgaagggagttgcgtagcgttgggcgtccatgaccgcagacggcctgaccgtgccgccccgagcagggcggcaggtgggccggctggtgttcggaccggtcacccgtacaggtgcgcctcgcatggcagacatggtgatggtgctcgccattatttactgtttgcggtttgcctgtaagatgccggagattcgagtgctctggggacgggaacctcagatcaaggtgaaggtctatcaagcacccaactcgacgctcagcatccgcacctggtctgatgtttccgcgcggcagggataattcgaatgcacgtccttgagttatctgagcctcttcgtaggtatctgagcccgcaggtggtttatagaagggccggctgggatatctggaatatggcacattgcaattctgacaagtgttagtctccccggatcaattcgatgtggcatccttccatgccagaattagcgagccagtcacccgcatgataattctcgacatacaaacatgcgctttggcaaatttgatttctggttttcgttcagatctgacttgataacccctgaacgatcgtcgcgatcattggtgccaacatttgacctgaagattgtctctgtcagccagctcggtaacttaagtcgacacagcatttacacaaaaacatgagtatataatgaattctgaacatcattttcacagacatcatcgcttcatggcatactcgatggtgtacatgcgggccatggaggcgaaccctcgcagatcgcctcctctcaacagattcccggcgtcgcagttcaggggagagtccggggccgagtctgacagcaaagccactatcgcctggcagaccgactgtgacattgtcagaataggagtatgctccattgtggttgtcagggaagcacatgattctggaggtagtgcaggccccattcattcatacccaatgtgaagtcattgttgaatggccaattgtcagggctgaaacctcccaggacattagcttacaactgtgaccctaaccccatagcgttcacgttacctgaagcgtccatgcagggctccacgcattcttcagtatatcgagacagatctcgccggtctgcagatgggtgtcaggttccaggcagtgtcaaccatcacgcagcgagtgggagaagggccaggtgcttgcaatgctataaatacccctccctatgataaacatgagcttcactggccttaaaatggacgttgggatggaagaggcgagtcttgaactttacgaccgggggcaccaaaggatactgctccggtacagtaatgctcagctcaaacactccaccgtggtatggggtttcagtgggaccctgcacttgggaagaggaaagtatggccacatcaaggtctgctgctgctctgcgatgtcaagtatgcgaggcacaaacctccagagtgcaccaggagccaaggaccacccctccttgcgggtccagttcataccgctattctggcttgccaaacgaagacatttgagtcgttcggaatcagctcgataccattgctgtctctagttctggatatctccttgagttcctgcagcggatcgtggggtgtgaattcacgttcccaggccagcgacttccgggacaccccccttccaggtgccatctcgccttgaagagccttgttcgggcagccatatgtactattatcaggcgacgtttgtgtaaaggagctatgcttgagaattatcccacagagctcctttctctcggggtgaacgactggggtcggcagcgtgcgggcgcgcgcgccggggaaggaccctttatgtcgaaacccgcagataagctggactaggccatgcgcatgacacgcgagttcccttcattggctcgcatataggagcaacgaaggttacacctgaccagcagcgggaccctcctggtctcatctcagcatggcacctgcgtgtgctgtgcattcttccggccccactctggctttgccccgctgcaggggctctgcgttacagaaaggtgacccggaatggtatgtcattgcctgtgctccgttgtatctttcgcgattccagcctacccaaaggcgaggccgtgggtcacctatcccacccatccaaggccaggtgcctggccccagaccacactccgggcgacaccacgccgctcagcacgaaacagcttcatggtaggcgcatgcaatgacccaggagccagttgccccgtttatgatgcctgcaacatgctctgcatgacccatttcccgcttcccatgccccgcccagacccgggcagccatgggggatgcgccgctgcgtgtgatgatttcaggagcaccggctgcaggcaaagggacccagtgcgccagcatcgtggaagatgtgggtgccggggtggtcaatgggagtggggggcactttggaaagggggaagggagggcgggcagtatagacttaggtggcaacgggattcttgggaggggacattggcacggtacctgagtcttcgagagtggcaatggcatctctgccccctaaaaacacctgtgcacggccttcttaccaccaccatccaaccctgtctcagtttggcctgacccacatcagcgcgggggatctgctgcgggctgaggtgtctgccggaacacctgctggaaagcgcgcctccgaattcatgaccgccggcaagcttgtcccaaacgaggtgtggggcttgagcgaggctctgtgatggtgggagtttgcagcatggacccctcctcctccgacgtcgcataggcggaagtgcggttctgccagccggcgctgacacgctcccttccatggcctctgtcccgactcgcaaccgcctgatcagctccctgtcatgggctcccacacggccccttcatctcaacattccctccttcccccccccccccccccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccggggctggctgctggacggctacccccgctcaccggagcaggcccaggccatcgaccgcgcgggcatccgccctgacgtcttcctcctgctcaatgtgaggcggtgctgcttgaactggtcccccgccccggggctgaaaggggtgggacattgggacctcaagcgcaggaagtccaccccaccccacccgcttgaacaccgagcctgctgatgccggatgtccctggggccacgtggtcagcagctgctccggccccctctgtcccgttccctgacagcatgattgactgccccagtccatgagccgtcccttcccccatgacgcacaccctccaatcaatcacctggccccaaggtacccgacgacgccctggtggcccgcgtcgtggggcggcggctggacccggtcacgggcgacatctaccacctgactttccgaccgccgccgaccgaggtcgcgccccgcctcgtccaacgcagcgacgacacggaggaggcggtgcgcacccggctggccacataccacgccaacctggacgccgtgctcggtttctacccagaccagatcgtgcaggtggggcgcagggcgcagggaattgtcgtttgattgggggggtggaggggtgggggggttcatgacgcaatggaatccctgcggaggaa

SEQ ID NO: 49201 - DNA, 2009 bp, Auxenochlorella protothecoides
  modified_base (850)..(987): a, c, t, g, unknown or other
  modified_base (1405)..(1414): a, c, t, g, unknown or other
cccaccacccagcgtacccaccacccagcgtacccaccacccagcgtacccaccacccagcgtacccaccacccagcgcacccaccacccaactcccccccagcccaccaacccccagaaatcacacacacacacaaacccacgcccacctgggcatggtagtgcgggatctggctgaagaggtggtggcagacgtgggtgtcagagatgtggtggaagaagacgtccaggaagggggggcccatagagcgatccacggtggccatggccccgcgcagccagtcccagtccttctcgtagtagtggggcagggcggggtgggtgtgctggagcagggtgatggtgaccagccaggcgttgaccacaaagtaggggacgacgtaggtcttgaccagccaggcggtgccgaaggagcgggccagcagccccaggcccgacaccaccgccaccagcgcggcgtcggacagcgccacctctgcgcgctcgcgcttggagaagatgggcgaccaagggtcgaagtggttggcgaagcgggggtaggggcgggaggaggcgttgaaggccaggtacaggggccagcccaggagcagggccaccgcgatgtgggcaaggcgggcgggggcggtctgctcccactcaaagccctcatggggctcctcgcgctgggcgggcacaaacacctcgtccttgtccacgcaccccgtgttggagtggtgccgacggtggctgtgcttccacgagtagtaggggaccaggaggagggagtggaacaccagcccaactccgtcattgatggtctgggacgtggagaaggcctggggcagaaacaagggggggggggggggagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagatagatagcgcagcgggagtgggctttcgaggggagccggcatggggtttcccagccgccttggccgcccagtgacagggggcacgaacactcggactgggcactgaggctcacaggagccatgcatggcattcgtaacaccaggggcggagccaacccgccatcgattcaaccccgctccgcacctgatggccgcactcgtgggcgatcacccagatgcccgtgccgaccgcgccctatacgaccggggggggagggtgacagcctcagcacaggcgacgggcgtgaggggtccgcgcccctcgcagcgcgtcgcaacaacctcgagagggcaccaacatggcatgtgcctacctggaagaaccagtacgtgggccagaggaaggtgtacttgaaccaggtcggcagaggggcnnnnnnnnnntaacatggcatgtgcctacctggaagaaccagtacgtgggccagaggaaggtgtacttgaaccaggtcggcagaggggcggggtcgatgtacgtcgacgccacatacagagccgcgaccagggccacatccaccatcagataggctgcgctgtgcagagctgatcgctcgaagcagtgggcagggatggccttgcgcagggtgccgatggtgaagggtggcttggccacgctctggcgcttcacggctgccatggggacagcagcccgacagggcggggctgcaaagctgtcttaaggcagtctcaaggggttgtcagcccaaaaaagtctcgatcaatctggccgagcccaagctgtacacgtcgcattgaatggatgacacggcccatggctaagtagccagagagattcgagtgcccctttcctgcgtcagcgaaaatcgcgccgggtttctacagattgtcaatcctccgcagaaccagcttctaacactattcttgctggggtttctcttgtatcttgccgtgctccctcaacagcgagtcggctgtagattttcgaatacctatgccttcttgtccgagtccgccgaat

SEQ ID NO: 49202 - DNA, 751 bp, Auxenochlorella protothecoides
aagtattgctggtcaaaatttatggttacctggatggttagaatcaattaataatgaaagtaattcattatttttaaacataggccctggtgatttcttagtgcatcatgcaattgctttaggactacatacaactacattaattgggatcaaaggtgctctagacgcgcgtggttcaaaattaatgccagataaaaaagattttggttatgctttcccttgtgatggtcctggacgtggtggtacttgtgatatttcagcttgggatgctttctatcttgctattttctggatgttaaatactataggttgggttactttttattggcattggaaacatcttggcatttggcaaggtaatgttagtcaatttaatgaatcgtctacttatttaatgggttggcttcgagattatttatggcttaattcttcacaacttattaatggttataatccttttgggatgaatagtctttctgtttgggcgtggatgtttttatttggtcatttagtgtatgcaacaggatttatgttcttaatttcttggcgtggttattggcaagaattaattgagactttagcttgggctcacgaaagaacacctttagctaatctaattcgttggcgcgacaaaccagtagcactttctattgttcaagcacgtttagtgggtttagcacatttttctgttggctatattcttacttatgctgctttcttaattgcttcgacttctggtaaattcggttaa

SEQ ID NO: 49203 - DNA, 751 bp, Auxenochlorella protothecoides
atggcaacaaaatttccaaaatttagtcaagccttagcacaagatccaactacacgtaggctttggtatggtttagccacagctcatgatttcgaaagtcatgatggtatgactgaagaacgtctttatcaaaaaatatttgcatcacattttggccaattagcgattatatttctttggacttctggaaacctttttcatgtagcttggcaaggaaatttcgagcagtgggttcaagatcctcttcatatccgaccaatagctcatgcaatctgggatccacattttgggcagccggccgtggaagcttttacacgtggcggtgcttcaggtccagtaaatatatctacatctggtgtttatcaatggtggtttactattgggctacgaactaaccaagatttatataatggatctatttttttaattatactttcagcattatttctatttgcaggctggttacatcttcaaccttcttttcagccaacgctttcatggtttaaaaatgcagaatcgcgattaaatcaccatttagcaggtctgtttggaataagttctctagcttgggcaggtcatttaattcatgtggctattcctgaatctcgtgggcaacatgtacgttggaataattttctgactgttttaccacatccggctggattaactcctttttttacaggtaattgggttgtatatgctcaaaacccagatgcagctactcatgtttggaatactaatgaaaacgctg

SEQ ID NO: 49204 - DNA, 549 bp, Artificial Sequence
  Description of Artificial Sequence: Synthetic polynucleotide
atgtcaggtgatgctcatcatgtaactcaaccaccaccagatggtcgaggtgctgctttagctatgcgacgagctttacgatcagctcgatgtgatccagatgaagtagcttatgtaaatgctcatgctacttcaactccacaaggtactggtgcttggtgttttgtacaaggtatgggttcattaggtactttatgtttagctattcatcaaccatcatgtcaaccaccaggtgatgctgtagaagctcgagctattgctcaagtatttggtggtcgaccatcattagctgtatcatcaactaaaggtgctatgggtcatttattaggtgctgctggtgctgtagaagctgctatggctgtattagctttatatcatggtgtagctccaccaactttaaatttagaagatccagaaccagctggtttattaccaggtttagtaggtccaactccattaactttaccaccaggtgctggtgctgtattaactaattcatttggttttggtggtactaatgctgctttagtatttactcgacatgctgct
